United States Patent 12,247,232 (METHODS AND COMPOSITIONS FOR INHIBITING ADAM 9 BIOLOGICAL ACTIVITIES) - sequence listing, part 3

SEQ ID NO: 17443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 17444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 17445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 17446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 17447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 17448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 17449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 17450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 17451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 17452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 17453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 17454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 17455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 17456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 17457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 17458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 17459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 17460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 17461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 17462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 17463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 17464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 17465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 17466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 17467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 17468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 17469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 17470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 17471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 17472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 17473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 17474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 17475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 17476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 17477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 17478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 17479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 17480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 17481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 17482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 17483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 17484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 17485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 17486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 17487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 17488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 17489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 17490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 17491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 17492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 17493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 17494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 17495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 17496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 17497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 17498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 17499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 17500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 17501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 17502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 17503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 17504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 17505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 17506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 17507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 17508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 17509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 17510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 17511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 17512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 17513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 17514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 17515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 17516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 17517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 17518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 17519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 17520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 17521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 17522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 17523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 17524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 17525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 17526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 17527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 17528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 17529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 17530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 17531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 17532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 17533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 17534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 17535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 17536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 17537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 17538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 17539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 17540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 17541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 17542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 17543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 17544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 17545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 17546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 17547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 17548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 17549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 17550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 17551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 17552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 17553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 17554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 17555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 17556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 17557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 17558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 17559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 17560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 17561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 17562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 17563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 17564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 17565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 17566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 17567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 17568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 17569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 17570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 17571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 17572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 17573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 17574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 17575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 17576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 17577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 17578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 17579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 17580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 17581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 17582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 17583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 17584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 17585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 17586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 17587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 17588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 17589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 17590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 17591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 17592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 17593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 17594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 17595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 17596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 17597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 17598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 17599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 17600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 17601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 17602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 17603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 17604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 17605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 17606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 17607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 17608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 17609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 17610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 17611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 17612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 17613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 17614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 17615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 17616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 17617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 17618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 17619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 17620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 17621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 17622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 17623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 17624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 17625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 17626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 17627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 17628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 17629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 17630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 17631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 17632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 17633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 17634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 17635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 17636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 17637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 17638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 17639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 17640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 17641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 17642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 17643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 17644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 17645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 17646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 17647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 17648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 17649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 17650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 17651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 17652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 17653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 17654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 17655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 17656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 17657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 17658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 17659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 17660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 17661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 17662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 17663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 17664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 17665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 17666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 17667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 17668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 17669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 17670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 17671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 17672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 17673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 17674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 17675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 17676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 17677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 17678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 17679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 17680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 17681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 17682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 17683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 17684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 17685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 17686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 17687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 17688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 17689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 17690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 17691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 17692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 17693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 17694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 17695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 17696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 17697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 17698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 17699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 17700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 17701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 17702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 17703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 17704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 17705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 17706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 17707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 17708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 17709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 17710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 17711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 17712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 17713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 17714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 17715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 17716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 17717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 17718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 17719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 17720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 17721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 17722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 17723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 17724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 17725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 17726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 17727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 17728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 17729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 17730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 17731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 17732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 17733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 17734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 17735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 17736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 17737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 17738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 17739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 17740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 17741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 17742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 17743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 17744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 17745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 17746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 17747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 17748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 17749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 17750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 17751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 17752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 17753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 17754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 17755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 17756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 17757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 17758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 17759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 17760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 17761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 17762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 17763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 17764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 17765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 17766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 17767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 17768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 17769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 17770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 17771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 17772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 17773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 17774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 17775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 17776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 17777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 17778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 17779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 17780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 17781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 17782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 17783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 17784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 17785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 17786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 17787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 17788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 17789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 17790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 17791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 17792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 17793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 17794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 17795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 17796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 17797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 17798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 17799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 17800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 17801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 17802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 17803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 17804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 17805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 17806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 17807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 17808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 17809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 17810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 17811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 17812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 17813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 17814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 17815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 17816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 17817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 17818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 17819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 17820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 17821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 17822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 17823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 17824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 17825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 17826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 17827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 17828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 17829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 17830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 17831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 17832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 17833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 17834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 17835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 17836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 17837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 17838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 17839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 17840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 17841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 17842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 17843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 17844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 17845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 17846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 17847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 17848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 17849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 17850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 17851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 17852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 17853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 17854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 17855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 17856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 17857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 17858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 17859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 17860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 17861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 17862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 17863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 17864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 17865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 17866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 17867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 17868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 17869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 17870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 17871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 17872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 17873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 17874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 17875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 17876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 17877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 17878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 17879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 17880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 17881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 17882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 17883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 17884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 17885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 17886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 17887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 17888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 17889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 17890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 17891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 17892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 17893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 17894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 17895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 17896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 17897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 17898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 17899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 17900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 17901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 17902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 17903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 17904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 17905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 17906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 17907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 17908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 17909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 17910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 17911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 17912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 17913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 17914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 17915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 17916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 17917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 17918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 17919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 17920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 17921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 17922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 17923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 17924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 17925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 17926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 17927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 17928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 17929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 17930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 17931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 17932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 17933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 17934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 17935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 17936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 17937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 17938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 17939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 17940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 17941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 17942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 17943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 17944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 17945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 17946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 17947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 17948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 17949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 17950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 17951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 17952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 17953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 17954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 17955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 17956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 17957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 17958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 17959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 17960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 17961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 17962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 17963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 17964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 17965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 17966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 17967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 17968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 17969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 17970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 17971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 17972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 17973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 17974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 17975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 17976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 17977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 17978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 17979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 17980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 17981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 17982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 17983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 17984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 17985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 17986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 17987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 17988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 17989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 17990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 17991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 17992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 17993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 17994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 17995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 17996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 17997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 17998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 17999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 18000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 18001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 18002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 18003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 18004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 18005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 18006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 18007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 18008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 18009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 18010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 18011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 18012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 18013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 18014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 18015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 18016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 18017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 18018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 18019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 18020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 18021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 18022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 18023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 18024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 18025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 18026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 18027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 18028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 18029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 18030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 18031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 18032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 18033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 18034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 18035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 18036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 18037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 18038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 18039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 18040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 18041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 18042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 18043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 18044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 18045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 18046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 18047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 18048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 18049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 18050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 18051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 18052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 18053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 18054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 18055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 18056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 18057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 18058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 18059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 18060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 18061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 18062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 18063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 18064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 18065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 18066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 18067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 18068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 18069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 18070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 18071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 18072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 18073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 18074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 18075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 18076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 18077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 18078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 18079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 18080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 18081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 18082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 18083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 18084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 18085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 18086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 18087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 18088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 18089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 18090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 18091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 18092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 18093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 18094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 18095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 18096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 18097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 18098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 18099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 18100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 18101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 18102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 18103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 18104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 18105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 18106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 18107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 18108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 18109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 18110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 18111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 18112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 18113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 18114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 18115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 18116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 18117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 18118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 18119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 18120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 18121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 18122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 18123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 18124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 18125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 18126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 18127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 18128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 18129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 18130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 18131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 18132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 18133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 18134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 18135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 18136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 18137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 18138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 18139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 18140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 18141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 18142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 18143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 18144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 18145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 18146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 18147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 18148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 18149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 18150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 18151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 18152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 18153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 18154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 18155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 18156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 18157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 18158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 18159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 18160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 18161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 18162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 18163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 18164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 18165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 18166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 18167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 18168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 18169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 18170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 18171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 18172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 18173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 18174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 18175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 18176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 18177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 18178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 18179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 18180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 18181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 18182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 18183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 18184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 18185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 18186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 18187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 18188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 18189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 18190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 18191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 18192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 18193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 18194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 18195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 18196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 18197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 18198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 18199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 18200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 18201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 18202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 18203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 18204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 18205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 18206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 18207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 18208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 18209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 18210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 18211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 18212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 18213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 18214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 18215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 18216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 18217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 18218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 18219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 18220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 18221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 18222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 18223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 18224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 18225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 18226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 18227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 18228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 18229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 18230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 18231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 18232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 18233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 18234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 18235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 18236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 18237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 18238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 18239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 18240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 18241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 18242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 18243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 18244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 18245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 18246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 18247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 18248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 18249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 18250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 18251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 18252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 18253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 18254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 18255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 18256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 18257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 18258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 18259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 18260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 18261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 18262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 18263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 18264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 18265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 18266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 18267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 18268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 18269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 18270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 18271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 18272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 18273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 18274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 18275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 18276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 18277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 18278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 18279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 18280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 18281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 18282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 18283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 18284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 18285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 18286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 18287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 18288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 18289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 18290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 18291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 18292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 18293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 18294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 18295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 18296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 18297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 18298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 18299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 18300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 18301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 18302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 18303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 18304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 18305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 18306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 18307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 18308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 18309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 18310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 18311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 18312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 18313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 18314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 18315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 18316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 18317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 18318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 18319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 18320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 18321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 18322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 18323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 18324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 18325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 18326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 18327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 18328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 18329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 18330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 18331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 18332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 18333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 18334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 18335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 18336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 18337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 18338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 18339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 18340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 18341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 18342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 18343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 18344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 18345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 18346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 18347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 18348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 18349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 18350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 18351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 18352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 18353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 18354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 18355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 18356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 18357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 18358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 18359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 18360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 18361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 18362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 18363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 18364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 18365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 18366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 18367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 18368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 18369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 18370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 18371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 18372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 18373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 18374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 18375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 18376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 18377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 18378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 18379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 18380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 18381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 18382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 18383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 18384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 18385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 18386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 18387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 18388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 18389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 18390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 18391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 18392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 18393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 18394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 18395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 18396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 18397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 18398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 18399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 18400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 18401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 18402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 18403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 18404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 18405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 18406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 18407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 18408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 18409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 18410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 18411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 18412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 18413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 18414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 18415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 18416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 18417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 18418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 18419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 18420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 18421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 18422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 18423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 18424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 18425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 18426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 18427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 18428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 18429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 18430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 18431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 18432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 18433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 18434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 18435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 18436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 18437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 18438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 18439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 18440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 18441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 18442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 18443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 18444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 18445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 18446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 18447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 18448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 18449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 18450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 18451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 18452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 18453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 18454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 18455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 18456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 18457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 18458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 18459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 18460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 18461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 18462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 18463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 18464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 18465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 18466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 18467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 18468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 18469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 18470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 18471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 18472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 18473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 18474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 18475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 18476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 18477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 18478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 18479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 18480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 18481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 18482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 18483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 18484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 18485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 18486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 18487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 18488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 18489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 18490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 18491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 18492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 18493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 18494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 18495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 18496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 18497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 18498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 18499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 18500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 18501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 18502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 18503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 18504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 18505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 18506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 18507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 18508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 18509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 18510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 18511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 18512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 18513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 18514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 18515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 18516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 18517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 18518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 18519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 18520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 18521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 18522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 18523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 18524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 18525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 18526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 18527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 18528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 18529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 18530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 18531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 18532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 18533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 18534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 18535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 18536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 18537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 18538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 18539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 18540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 18541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 18542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 18543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 18544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 18545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 18546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 18547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 18548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 18549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 18550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 18551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 18552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 18553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 18554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 18555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 18556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 18557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 18558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 18559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 18560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 18561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 18562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 18563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 18564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 18565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 18566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 18567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 18568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 18569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 18570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 18571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 18572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 18573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 18574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 18575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 18576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 18577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 18578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 18579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 18580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 18581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 18582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 18583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 18584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 18585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 18586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 18587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 18588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 18589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 18590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 18591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 18592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 18593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 18594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 18595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 18596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 18597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 18598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 18599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 18600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 18601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 18602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 18603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 18604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 18605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 18606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 18607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 18608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 18609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 18610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 18611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 18612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 18613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 18614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 18615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 18616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 18617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 18618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 18619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 18620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 18621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 18622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 18623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 18624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 18625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 18626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 18627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 18628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 18629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 18630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 18631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 18632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 18633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 18634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 18635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 18636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 18637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 18638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 18639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 18640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 18641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 18642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 18643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 18644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 18645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 18646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 18647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 18648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 18649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 18650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 18651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 18652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 18653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 18654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 18655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 18656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 18657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 18658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 18659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 18660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 18661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 18662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 18663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 18664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 18665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 18666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 18667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 18668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 18669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 18670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 18671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 18672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 18673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 18674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 18675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 18676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 18677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 18678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 18679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 18680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 18681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 18682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 18683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 18684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 18685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 18686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 18687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 18688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 18689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 18690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 18691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 18692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 18693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 18694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 18695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 18696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 18697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 18698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 18699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 18700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 18701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 18702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 18703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 18704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 18705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 18706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 18707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 18708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 18709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 18710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 18711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 18712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 18713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 18714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 18715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 18716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 18717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 18718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 18719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 18720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 18721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 18722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 18723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 18724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 18725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 18726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 18727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 18728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 18729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 18730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 18731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 18732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 18733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 18734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 18735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 18736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 18737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 18738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 18739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 18740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 18741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 18742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 18743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 18744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 18745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 18746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 18747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 18748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 18749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 18750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 18751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 18752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 18753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 18754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 18755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 18756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 18757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 18758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 18759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 18760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 18761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 18762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 18763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 18764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 18765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 18766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 18767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 18768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 18769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 18770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 18771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 18772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 18773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 18774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 18775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 18776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 18777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 18778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 18779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 18780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 18781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 18782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 18783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 18784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 18785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 18786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 18787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 18788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 18789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 18790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 18791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 18792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 18793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 18794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 18795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 18796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 18797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 18798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 18799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 18800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 18801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 18802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 18803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 18804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 18805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 18806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 18807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 18808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 18809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 18810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 18811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 18812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 18813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 18814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 18815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 18816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 18817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 18818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 18819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 18820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 18821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 18822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 18823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 18824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 18825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 18826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 18827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 18828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 18829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 18830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 18831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 18832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 18833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 18834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 18835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 18836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 18837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 18838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 18839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 18840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 18841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 18842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 18843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 18844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 18845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 18846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 18847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 18848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 18849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 18850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 18851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 18852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 18853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 18854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 18855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 18856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 18857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 18858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 18859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 18860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 18861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 18862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 18863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 18864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 18865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 18866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 18867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 18868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 18869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 18870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 18871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 18872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 18873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 18874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 18875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 18876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 18877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 18878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 18879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 18880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 18881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 18882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 18883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 18884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 18885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 18886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 18887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 18888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 18889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 18890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 18891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 18892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 18893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 18894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 18895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 18896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 18897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 18898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 18899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 18900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 18901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 18902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 18903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 18904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 18905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 18906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 18907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 18908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 18909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 18910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 18911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 18912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 18913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 18914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 18915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 18916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 18917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 18918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 18919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 18920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 18921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 18922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 18923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 18924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 18925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 18926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 18927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 18928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 18929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 18930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 18931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 18932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 18933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 18934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 18935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 18936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 18937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 18938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 18939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 18940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 18941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 18942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 18943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 18944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 18945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 18946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 18947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 18948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 18949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 18950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 18951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 18952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 18953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 18954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 18955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 18956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 18957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 18958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 18959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 18960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 18961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 18962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 18963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 18964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 18965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 18966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 18967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 18968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 18969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 18970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 18971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 18972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 18973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 18974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 18975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 18976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 18977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 18978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 18979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 18980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 18981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 18982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 18983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 18984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 18985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 18986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 18987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 18988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 18989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 18990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 18991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 18992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 18993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 18994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 18995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 18996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 18997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 18998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 18999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 19000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 19001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 19002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 19003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 19004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 19005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 19006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 19007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 19008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 19009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 19010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 19011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 19012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 19013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 19014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 19015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 19016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 19017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 19018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 19019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 19020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 19021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 19022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 19023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 19024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 19025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 19026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 19027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 19028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 19029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 19030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 19031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 19032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 19033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 19034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 19035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 19036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 19037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 19038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 19039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 19040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 19041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 19042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 19043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 19044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 19045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 19046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 19047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 19048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 19049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 19050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 19051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 19052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 19053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 19054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 19055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 19056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 19057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 19058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 19059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 19060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 19061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 19062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 19063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 19064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 19065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 19066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 19067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 19068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 19069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 19070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 19071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 19072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 19073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 19074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 19075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 19076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 19077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 19078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 19079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 19080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 19081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 19082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 19083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 19084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 19085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 19086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 19087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 19088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 19089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 19090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 19091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 19092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 19093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 19094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 19095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 19096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 19097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 19098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 19099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 19100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 19101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 19102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 19103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 19104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 19105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 19106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 19107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 19108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 19109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 19110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 19111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 19112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 19113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 19114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 19115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 19116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 19117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 19118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 19119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 19120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 19121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 19122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 19123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 19124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 19125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 19126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 19127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 19128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 19129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 19130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 19131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 19132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 19133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 19134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 19135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 19136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 19137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 19138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 19139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 19140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 19141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 19142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 19143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 19144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 19145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 19146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 19147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 19148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 19149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 19150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 19151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 19152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 19153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 19154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 19155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 19156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 19157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 19158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 19159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 19160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 19161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 19162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 19163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 19164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 19165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 19166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 19167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 19168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 19169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 19170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 19171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 19172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 19173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 19174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 19175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 19176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 19177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 19178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 19179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 19180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 19181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 19182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 19183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 19184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 19185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 19186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 19187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 19188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 19189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 19190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 19191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 19192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 19193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 19194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 19195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 19196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 19197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 19198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 19199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 19200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 19201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 19202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 19203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 19204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 19205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 19206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 19207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 19208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 19209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 19210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 19211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 19212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 19213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 19214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 19215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 19216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 19217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 19218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 19219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 19220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 19221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 19222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 19223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 19224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 19225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 19226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 19227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 19228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 19229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 19230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 19231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 19232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 19233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 19234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 19235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 19236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 19237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 19238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 19239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 19240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 19241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 19242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 19243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 19244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 19245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 19246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 19247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 19248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 19249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 19250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 19251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 19252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 19253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 19254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 19255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 19256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 19257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 19258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 19259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 19260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 19261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 19262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 19263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 19264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 19265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 19266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 19267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 19268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 19269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 19270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 19271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 19272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 19273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 19274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 19275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 19276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 19277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 19278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 19279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 19280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 19281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 19282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 19283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 19284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 19285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 19286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 19287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 19288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 19289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 19290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 19291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 19292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 19293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 19294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 19295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 19296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 19297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 19298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 19299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 19300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 19301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 19302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 19303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 19304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 19305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 19306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 19307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 19308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 19309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 19310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 19311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 19312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 19313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 19314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 19315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 19316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 19317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 19318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 19319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 19320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 19321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 19322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 19323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 19324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 19325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 19326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 19327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 19328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 19329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 19330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 19331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 19332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 19333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 19334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 19335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 19336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 19337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 19338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 19339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 19340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 19341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 19342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 19343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 19344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 19345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 19346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 19347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 19348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 19349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 19350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 19351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 19352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 19353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 19354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 19355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 19356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 19357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 19358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 19359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 19360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 19361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 19362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 19363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 19364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 19365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 19366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 19367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 19368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 19369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 19370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 19371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 19372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 19373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 19374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 19375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 19376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 19377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 19378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 19379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 19380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 19381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 19382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 19383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 19384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 19385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 19386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 19387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 19388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 19389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 19390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 19391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 19392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 19393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 19394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 19395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 19396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 19397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 19398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 19399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 19400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 19401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 19402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 19403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 19404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 19405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 19406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 19407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 19408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 19409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 19410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 19411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 19412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 19413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 19414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 19415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 19416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 19417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 19418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 19419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 19420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 19421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 19422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 19423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 19424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 19425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 19426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 19427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 19428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 19429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 19430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 19431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 19432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 19433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 19434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 19435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 19436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 19437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 19438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 19439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 19440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 19441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 19442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 19443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 19444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 19445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 19446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 19447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 19448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 19449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 19450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 19451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 19452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 19453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 19454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 19455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 19456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 19457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 19458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 19459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 19460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 19461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 19462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 19463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 19464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 19465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 19466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 19467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 19468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 19469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 19470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 19471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 19472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 19473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 19474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 19475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 19476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 19477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 19478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 19479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 19480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 19481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 19482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 19483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 19484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 19485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 19486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 19487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 19488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 19489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 19490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 19491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 19492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 19493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 19494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 19495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 19496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 19497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 19498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 19499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 19500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 19501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 19502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 19503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 19504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 19505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 19506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 19507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 19508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 19509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 19510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 19511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 19512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 19513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 19514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 19515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 19516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 19517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 19518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 19519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 19520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 19521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 19522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 19523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 19524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 19525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 19526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 19527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 19528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 19529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 19530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 19531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 19532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 19533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 19534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 19535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 19536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 19537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 19538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 19539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 19540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 19541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 19542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 19543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 19544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 19545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 19546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 19547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 19548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 19549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 19550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 19551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 19552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 19553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 19554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 19555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 19556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 19557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 19558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 19559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 19560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 19561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 19562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 19563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 19564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 19565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 19566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 19567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 19568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 19569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 19570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 19571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 19572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 19573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 19574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 19575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 19576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 19577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 19578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 19579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 19580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 19581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 19582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 19583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 19584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 19585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 19586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 19587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 19588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 19589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 19590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 19591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 19592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 19593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 19594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 19595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 19596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 19597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 19598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 19599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 19600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 19601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 19602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 19603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 19604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 19605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 19606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 19607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 19608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 19609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 19610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 19611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 19612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 19613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 19614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 19615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 19616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 19617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 19618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 19619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 19620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 19621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 19622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 19623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 19624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 19625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 19626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 19627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 19628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 19629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 19630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 19631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 19632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 19633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 19634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 19635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 19636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 19637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 19638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 19639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 19640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 19641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 19642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 19643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 19644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 19645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 19646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 19647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 19648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 19649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 19650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 19651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 19652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 19653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 19654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 19655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 19656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 19657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 19658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 19659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 19660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 19661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 19662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 19663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 19664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 19665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 19666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 19667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 19668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 19669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 19670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 19671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 19672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 19673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 19674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 19675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 19676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 19677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 19678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 19679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 19680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 19681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 19682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 19683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 19684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 19685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 19686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 19687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 19688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 19689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 19690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 19691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 19692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 19693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 19694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 19695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 19696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 19697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 19698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 19699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 19700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 19701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 19702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 19703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 19704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 19705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 19706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 19707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 19708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 19709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 19710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 19711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 19712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 19713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 19714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 19715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 19716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 19717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 19718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 19719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 19720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 19721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 19722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 19723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 19724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 19725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 19726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 19727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 19728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 19729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 19730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 19731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 19732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 19733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 19734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 19735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 19736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 19737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 19738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 19739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 19740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 19741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 19742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 19743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 19744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 19745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 19746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 19747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 19748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 19749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 19750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 19751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 19752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 19753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 19754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 19755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 19756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 19757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 19758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 19759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 19760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 19761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 19762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 19763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 19764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 19765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 19766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 19767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 19768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 19769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 19770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 19771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 19772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 19773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 19774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 19775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 19776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 19777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 19778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 19779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 19780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 19781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 19782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 19783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 19784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 19785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 19786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 19787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 19788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 19789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 19790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 19791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 19792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 19793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 19794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 19795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 19796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 19797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 19798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 19799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 19800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 19801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 19802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 19803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 19804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 19805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 19806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 19807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 19808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 19809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 19810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 19811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 19812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 19813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 19814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 19815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 19816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 19817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 19818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 19819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 19820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 19821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 19822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 19823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 19824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 19825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 19826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 19827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 19828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 19829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 19830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 19831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 19832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 19833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 19834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 19835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 19836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 19837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 19838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 19839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 19840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 19841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 19842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 19843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 19844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 19845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 19846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 19847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 19848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 19849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 19850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 19851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 19852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 19853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 19854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 19855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 19856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 19857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 19858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 19859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 19860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 19861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 19862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 19863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 19864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 19865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 19866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 19867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 19868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 19869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 19870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 19871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 19872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 19873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 19874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 19875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 19876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 19877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 19878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 19879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 19880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 19881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 19882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 19883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 19884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 19885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 19886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 19887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 19888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 19889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 19890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 19891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 19892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 19893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 19894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 19895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 19896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 19897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 19898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 19899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 19900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 19901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 19902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 19903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 19904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 19905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 19906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 19907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 19908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 19909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 19910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 19911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 19912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 19913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 19914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 19915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 19916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 19917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 19918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 19919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 19920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 19921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 19922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 19923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 19924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 19925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 19926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 19927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 19928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 19929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 19930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 19931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 19932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 19933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 19934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 19935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 19936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 19937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 19938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 19939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 19940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 19941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 19942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 19943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 19944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 19945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 19946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 19947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 19948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 19949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 19950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 19951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 19952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 19953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 19954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 19955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 19956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 19957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 19958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 19959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 19960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 19961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 19962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 19963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 19964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 19965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 19966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 19967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 19968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 19969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 19970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 19971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 19972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 19973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 19974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 19975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 19976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 19977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 19978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 19979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 19980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 19981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 19982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 19983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 19984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 19985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 19986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 19987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 19988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 19989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 19990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 19991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 19992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 19993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 19994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 19995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 19996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 19997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 19998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 19999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 20000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 20001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 20002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 20003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 20004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 20005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 20006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 20007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 20008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 20009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 20010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 20011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 20012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 20013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 20014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 20015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 20016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 20017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 20018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 20019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 20020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 20021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 20022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 20023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 20024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 20025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 20026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 20027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 20028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 20029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 20030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 20031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 20032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 20033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 20034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 20035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 20036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 20037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 20038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 20039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 20040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 20041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 20042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 20043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 20044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 20045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 20046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 20047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 20048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 20049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 20050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 20051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 20052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 20053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 20054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 20055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 20056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 20057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 20058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 20059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 20060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 20061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 20062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 20063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 20064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 20065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 20066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 20067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 20068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 20069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 20070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 20071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 20072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 20073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 20074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 20075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 20076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 20077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 20078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 20079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 20080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 20081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 20082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 20083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 20084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 20085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 20086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 20087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 20088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 20089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 20090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 20091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 20092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 20093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 20094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 20095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 20096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 20097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 20098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 20099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 20100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 20101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 20102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 20103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 20104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 20105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 20106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 20107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 20108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 20109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 20110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 20111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 20112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 20113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 20114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 20115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 20116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 20117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 20118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 20119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 20120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 20121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 20122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 20123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 20124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 20125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 20126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 20127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 20128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 20129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 20130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 20131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 20132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 20133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 20134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 20135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 20136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 20137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 20138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 20139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 20140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 20141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 20142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 20143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 20144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 20145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 20146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 20147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 20148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 20149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 20150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 20151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 20152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 20153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 20154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 20155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 20156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 20157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 20158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 20159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 20160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 20161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 20162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 20163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 20164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 20165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 20166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 20167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 20168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 20169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 20170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 20171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 20172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 20173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 20174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 20175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 20176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 20177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 20178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 20179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 20180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 20181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 20182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 20183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 20184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 20185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 20186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 20187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 20188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 20189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 20190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 20191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 20192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 20193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 20194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 20195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 20196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 20197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 20198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 20199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 20200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 20201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 20202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 20203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 20204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 20205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 20206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 20207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 20208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 20209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 20210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 20211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 20212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 20213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 20214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 20215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 20216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 20217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 20218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 20219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 20220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 20221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 20222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 20223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 20224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 20225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 20226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 20227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 20228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 20229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 20230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 20231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 20232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 20233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 20234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 20235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 20236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 20237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 20238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 20239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 20240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 20241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 20242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 20243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 20244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 20245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 20246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 20247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 20248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 20249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 20250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 20251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 20252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 20253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 20254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 20255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 20256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 20257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 20258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 20259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 20260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 20261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 20262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 20263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 20264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 20265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 20266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 20267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 20268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 20269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 20270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 20271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 20272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 20273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 20274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 20275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 20276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 20277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 20278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 20279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 20280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 20281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 20282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 20283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 20284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 20285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 20286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 20287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 20288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 20289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 20290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 20291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 20292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 20293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 20294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 20295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 20296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 20297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 20298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 20299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 20300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 20301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 20302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 20303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 20304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 20305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 20306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 20307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 20308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 20309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 20310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 20311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 20312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 20313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 20314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 20315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 20316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 20317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 20318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 20319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 20320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 20321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 20322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 20323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 20324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 20325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 20326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 20327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 20328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 20329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 20330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 20331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 20332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 20333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 20334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 20335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 20336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 20337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 20338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 20339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 20340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 20341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 20342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 20343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 20344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 20345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 20346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 20347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 20348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 20349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 20350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 20351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 20352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 20353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 20354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 20355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 20356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 20357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 20358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 20359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 20360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 20361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 20362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 20363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 20364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 20365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 20366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 20367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 20368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 20369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 20370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 20371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 20372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 20373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 20374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 20375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 20376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 20377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 20378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 20379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 20380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 20381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 20382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 20383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 20384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 20385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 20386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 20387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 20388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 20389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 20390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 20391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 20392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 20393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 20394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 20395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 20396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 20397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 20398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 20399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 20400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 20401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 20402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 20403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 20404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 20405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 20406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 20407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 20408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 20409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 20410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 20411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 20412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 20413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 20414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 20415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 20416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 20417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 20418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 20419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 20420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 20421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 20422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 20423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 20424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 20425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 20426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 20427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 20428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 20429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 20430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 20431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 20432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 20433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 20434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 20435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 20436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 20437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 20438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 20439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 20440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 20441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 20442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 20443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 20444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 20445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 20446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 20447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 20448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 20449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 20450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 20451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 20452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 20453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 20454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 20455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 20456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 20457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 20458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 20459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 20460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 20461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 20462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 20463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 20464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 20465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 20466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 20467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 20468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 20469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 20470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 20471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 20472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 20473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 20474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 20475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 20476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 20477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 20478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 20479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 20480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 20481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 20482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 20483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 20484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 20485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 20486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 20487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 20488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 20489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 20490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 20491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 20492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 20493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 20494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 20495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 20496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 20497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 20498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 20499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 20500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 20501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 20502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 20503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 20504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 20505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 20506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 20507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 20508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 20509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 20510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 20511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 20512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 20513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 20514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 20515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 20516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 20517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 20518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 20519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 20520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 20521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 20522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 20523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 20524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 20525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 20526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 20527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 20528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 20529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 20530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 20531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 20532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 20533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 20534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 20535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 20536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 20537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 20538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 20539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 20540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 20541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 20542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 20543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 20544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 20545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 20546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 20547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 20548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 20549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 20550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 20551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 20552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 20553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 20554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 20555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 20556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 20557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 20558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 20559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 20560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 20561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 20562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 20563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 20564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 20565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 20566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 20567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 20568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 20569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 20570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 20571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 20572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 20573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 20574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 20575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 20576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 20577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 20578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 20579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 20580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 20581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 20582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 20583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 20584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 20585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 20586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 20587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 20588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 20589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 20590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 20591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 20592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 20593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 20594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 20595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 20596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 20597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 20598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 20599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 20600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 20601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 20602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 20603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 20604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 20605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 20606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 20607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 20608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 20609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 20610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 20611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 20612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 20613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 20614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 20615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 20616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 20617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 20618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 20619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 20620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 20621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 20622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 20623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 20624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 20625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 20626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 20627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 20628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 20629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 20630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 20631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 20632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 20633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 20634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 20635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 20636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 20637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 20638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 20639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 20640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 20641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 20642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 20643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 20644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 20645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 20646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 20647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 20648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 20649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 20650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 20651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 20652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 20653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 20654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 20655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 20656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 20657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 20658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 20659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 20660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 20661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 20662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 20663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 20664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 20665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 20666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 20667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 20668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 20669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 20670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 20671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 20672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 20673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 20674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 20675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 20676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 20677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 20678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 20679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 20680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 20681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 20682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 20683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 20684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 20685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 20686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 20687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 20688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 20689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 20690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 20691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 20692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 20693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 20694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 20695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 20696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 20697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 20698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 20699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 20700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 20701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 20702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 20703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 20704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 20705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 20706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 20707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 20708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 20709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 20710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 20711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 20712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 20713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 20714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 20715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 20716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 20717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 20718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 20719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 20720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 20721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 20722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 20723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 20724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 20725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 20726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 20727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 20728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 20729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 20730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 20731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 20732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 20733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 20734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 20735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 20736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 20737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 20738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 20739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 20740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 20741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 20742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 20743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 20744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 20745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 20746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 20747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 20748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 20749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 20750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 20751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 20752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 20753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 20754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 20755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 20756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 20757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 20758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 20759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 20760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 20761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 20762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 20763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 20764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 20765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 20766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 20767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 20768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 20769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 20770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 20771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 20772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 20773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 20774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 20775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 20776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 20777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 20778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 20779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 20780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 20781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 20782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 20783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 20784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 20785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 20786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 20787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 20788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 20789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 20790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 20791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 20792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 20793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 20794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 20795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 20796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 20797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 20798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 20799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 20800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 20801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 20802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 20803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 20804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 20805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 20806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 20807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 20808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 20809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 20810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 20811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 20812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 20813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 20814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 20815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 20816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 20817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 20818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 20819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 20820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 20821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 20822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 20823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 20824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 20825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 20826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 20827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 20828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 20829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 20830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 20831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 20832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 20833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 20834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 20835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 20836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 20837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 20838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 20839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 20840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 20841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 20842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 20843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 20844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 20845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 20846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 20847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 20848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 20849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 20850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 20851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 20852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 20853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 20854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 20855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 20856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 20857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 20858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 20859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 20860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 20861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 20862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 20863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 20864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 20865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 20866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 20867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 20868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 20869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 20870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 20871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 20872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 20873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 20874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 20875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 20876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 20877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 20878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 20879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 20880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 20881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 20882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 20883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 20884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 20885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 20886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 20887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 20888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 20889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 20890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 20891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 20892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 20893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 20894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 20895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 20896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 20897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 20898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 20899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 20900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 20901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 20902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 20903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 20904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 20905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 20906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 20907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 20908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 20909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 20910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 20911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 20912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 20913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 20914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 20915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 20916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 20917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 20918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 20919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 20920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 20921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 20922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 20923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 20924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 20925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 20926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 20927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 20928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 20929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 20930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 20931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 20932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 20933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 20934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 20935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 20936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 20937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 20938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 20939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 20940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 20941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 20942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 20943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 20944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 20945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 20946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 20947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 20948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 20949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 20950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 20951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 20952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 20953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 20954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 20955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 20956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 20957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 20958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 20959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 20960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 20961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 20962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 20963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 20964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 20965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 20966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 20967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 20968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 20969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 20970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 20971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 20972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 20973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 20974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 20975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 20976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 20977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 20978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 20979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 20980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 20981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 20982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 20983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 20984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 20985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 20986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 20987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 20988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 20989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 20990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 20991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 20992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 20993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 20994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 20995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 20996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 20997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 20998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 20999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 21000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 21001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 21002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 21003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 21004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 21005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 21006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 21007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 21008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 21009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 21010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 21011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 21012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 21013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 21014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 21015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 21016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 21017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 21018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 21019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 21020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 21021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 21022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 21023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 21024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 21025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 21026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 21027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 21028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 21029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 21030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 21031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 21032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 21033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 21034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 21035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 21036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 21037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 21038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 21039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 21040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 21041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 21042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 21043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 21044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 21045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 21046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 21047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 21048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 21049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 21050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 21051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 21052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 21053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 21054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 21055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 21056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 21057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 21058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 21059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 21060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 21061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 21062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 21063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 21064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 21065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 21066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 21067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 21068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 21069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 21070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 21071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 21072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 21073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 21074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 21075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 21076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 21077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 21078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 21079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 21080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 21081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 21082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 21083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 21084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 21085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 21086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 21087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 21088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 21089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 21090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 21091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 21092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 21093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 21094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 21095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 21096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 21097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 21098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 21099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 21100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 21101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 21102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 21103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 21104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 21105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 21106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 21107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 21108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 21109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 21110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 21111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 21112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 21113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 21114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 21115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 21116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 21117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 21118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 21119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 21120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 21121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 21122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 21123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 21124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 21125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 21126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 21127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 21128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 21129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 21130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 21131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 21132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 21133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 21134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 21135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 21136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 21137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 21138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 21139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 21140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 21141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 21142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 21143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 21144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 21145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 21146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 21147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 21148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 21149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 21150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 21151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 21152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 21153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 21154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 21155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 21156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 21157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 21158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 21159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 21160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 21161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 21162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 21163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 21164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 21165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 21166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 21167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 21168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 21169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 21170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 21171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 21172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 21173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 21174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 21175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 21176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 21177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 21178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 21179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 21180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 21181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 21182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 21183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 21184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 21185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 21186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 21187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 21188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 21189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 21190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 21191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 21192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 21193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 21194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 21195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 21196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 21197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 21198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 21199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 21200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 21201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 21202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 21203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 21204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 21205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 21206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 21207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 21208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 21209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 21210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 21211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 21212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 21213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 21214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 21215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 21216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 21217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 21218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 21219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 21220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 21221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 21222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 21223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 21224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 21225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 21226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 21227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 21228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 21229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 21230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 21231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 21232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 21233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 21234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 21235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 21236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 21237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 21238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 21239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 21240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 21241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 21242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 21243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 21244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 21245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 21246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 21247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 21248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 21249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 21250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 21251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 21252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 21253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 21254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 21255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 21256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 21257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 21258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 21259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 21260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 21261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 21262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 21263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 21264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 21265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 21266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 21267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 21268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 21269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 21270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 21271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 21272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 21273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 21274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 21275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 21276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 21277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 21278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 21279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 21280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 21281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 21282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 21283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 21284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 21285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 21286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 21287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 21288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 21289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 21290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 21291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 21292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 21293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 21294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 21295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 21296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 21297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 21298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 21299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 21300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 21301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 21302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 21303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 21304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 21305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 21306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 21307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 21308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 21309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 21310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 21311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 21312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 21313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 21314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 21315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 21316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 21317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 21318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 21319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 21320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 21321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 21322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 21323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 21324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 21325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 21326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 21327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 21328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 21329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 21330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 21331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 21332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 21333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 21334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 21335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 21336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 21337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 21338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 21339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 21340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 21341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 21342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 21343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 21344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 21345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 21346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 21347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 21348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 21349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 21350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 21351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 21352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 21353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 21354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 21355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 21356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 21357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 21358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 21359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 21360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 21361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 21362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 21363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 21364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 21365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 21366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 21367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 21368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 21369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 21370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 21371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 21372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 21373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 21374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 21375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 21376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 21377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 21378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 21379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 21380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 21381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 21382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 21383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 21384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 21385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 21386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 21387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 21388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 21389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 21390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 21391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 21392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 21393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 21394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 21395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 21396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 21397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 21398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 21399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 21400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 21401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 21402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 21403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 21404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 21405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 21406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 21407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 21408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 21409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 21410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 21411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 21412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 21413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 21414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 21415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 21416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 21417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 21418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 21419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 21420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 21421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 21422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 21423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 21424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 21425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 21426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 21427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 21428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 21429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 21430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 21431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 21432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 21433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 21434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 21435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 21436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 21437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 21438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 21439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 21440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 21441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 21442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 21443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 21444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 21445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 21446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 21447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 21448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 21449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 21450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 21451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 21452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 21453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 21454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 21455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 21456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 21457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 21458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 21459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 21460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 21461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 21462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 21463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 21464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 21465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 21466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 21467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 21468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 21469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 21470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 21471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 21472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 21473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 21474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 21475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 21476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 21477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 21478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 21479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 21480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 21481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 21482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 21483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 21484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 21485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 21486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 21487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 21488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 21489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 21490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 21491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 21492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 21493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 21494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 21495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 21496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 21497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 21498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 21499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 21500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 21501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 21502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 21503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 21504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 21505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 21506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 21507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 21508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 21509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 21510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 21511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 21512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 21513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 21514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 21515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 21516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 21517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 21518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 21519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 21520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 21521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 21522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 21523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 21524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 21525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 21526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 21527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 21528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 21529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 21530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 21531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 21532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 21533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 21534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 21535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 21536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 21537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 21538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 21539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 21540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 21541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 21542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 21543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 21544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 21545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 21546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 21547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 21548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 21549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 21550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 21551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 21552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 21553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 21554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 21555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 21556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 21557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 21558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 21559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 21560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 21561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 21562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 21563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 21564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 21565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 21566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 21567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 21568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 21569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 21570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 21571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 21572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 21573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 21574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 21575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 21576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 21577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 21578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 21579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 21580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 21581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 21582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 21583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 21584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 21585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 21586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 21587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 21588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 21589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 21590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 21591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 21592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 21593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 21594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 21595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 21596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 21597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 21598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 21599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 21600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 21601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 21602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 21603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 21604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 21605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 21606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 21607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 21608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 21609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 21610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 21611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 21612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 21613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 21614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 21615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 21616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 21617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 21618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 21619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 21620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 21621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 21622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 21623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 21624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 21625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 21626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 21627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHKHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 21628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 21629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 21630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 21631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 21632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 21633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 21634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 21635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 21636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 21637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 21638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 21639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 21640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 21641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 21642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 21643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 21644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 21645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 21646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 21647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 21648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 21649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 21650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 21651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 21652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 21653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 21654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 21655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 21656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 21657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 21658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 21659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 21660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 21661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 21662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 21663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 21664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 21665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 21666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 21667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 21668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 21669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 21670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 21671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 21672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 21673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 21674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 21675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 21676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 21677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 21678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 21679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 21680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 21681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 21682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 21683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 21684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 21685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 21686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 21687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 21688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 21689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 21690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 21691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 21692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 21693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 21694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 21695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 21696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 21697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 21698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 21699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 21700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 21701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 21702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 21703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 21704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 21705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 21706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 21707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 21708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 21709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 21710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 21711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 21712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 21713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 21714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 21715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 21716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 21717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 21718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 21719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 21720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 21721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 21722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 21723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 21724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 21725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 21726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 21727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 21728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 21729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 21730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 21731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 21732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 21733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 21734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 21735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 21736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 21737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 21738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 21739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 21740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 21741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 21742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 21743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 21744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 21745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 21746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 21747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 21748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 21749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 21750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 21751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 21752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 21753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 21754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 21755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 21756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 21757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 21758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 21759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 21760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 21761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 21762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 21763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 21764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 21765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 21766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 21767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 21768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 21769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 21770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 21771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 21772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 21773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 21774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 21775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 21776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 21777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 21778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 21779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 21780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 21781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 21782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 21783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 21784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 21785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 21786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 21787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 21788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 21789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 21790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 21791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 21792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 21793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 21794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 21795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 21796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 21797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 21798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 21799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 21800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 21801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 21802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 21803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 21804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 21805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 21806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 21807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 21808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 21809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 21810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 21811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 21812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 21813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 21814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 21815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 21816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 21817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 21818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 21819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 21820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 21821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 21822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 21823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 21824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 21825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 21826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 21827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 21828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 21829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 21830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 21831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 21832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 21833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 21834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 21835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 21836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 21837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 21838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 21839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 21840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 21841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 21842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 21843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 21844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 21845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 21846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 21847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 21848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 21849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 21850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 21851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 21852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 21853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 21854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 21855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 21856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 21857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 21858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 21859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 21860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 21861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 21862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 21863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 21864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 21865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 21866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 21867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 21868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 21869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 21870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 21871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 21872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 21873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 21874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 21875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 21876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 21877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 21878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 21879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 21880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 21881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 21882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 21883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 21884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 21885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 21886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 21887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 21888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 21889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 21890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 21891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 21892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 21893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 21894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 21895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 21896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 21897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 21898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 21899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 21900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 21901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 21902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 21903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 21904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 21905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 21906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 21907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 21908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 21909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 21910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 21911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 21912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 21913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 21914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 21915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 21916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 21917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 21918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 21919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 21920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 21921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 21922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 21923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 21924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 21925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 21926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 21927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 21928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 21929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 21930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 21931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 21932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 21933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 21934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 21935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 21936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 21937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 21938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 21939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 21940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 21941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 21942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 21943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 21944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 21945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 21946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 21947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 21948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 21949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 21950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 21951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 21952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 21953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 21954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 21955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 21956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 21957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 21958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 21959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 21960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 21961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 21962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 21963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 21964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 21965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 21966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 21967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 21968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 21969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 21970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 21971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 21972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 21973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 21974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 21975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 21976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 21977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 21978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 21979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 21980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 21981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 21982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 21983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 21984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 21985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 21986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 21987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 21988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 21989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 21990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 21991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 21992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 21993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 21994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 21995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 21996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 21997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 21998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 21999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 22000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 22001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 22002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 22003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 22004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 22005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 22006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 22007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 22008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 22009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 22010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 22011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 22012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 22013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 22014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 22015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 22016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 22017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 22018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 22019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 22020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 22021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 22022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 22023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 22024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 22025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 22026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 22027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 22028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 22029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 22030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 22031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 22032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 22033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 22034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 22035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 22036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 22037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 22038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 22039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 22040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 22041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 22042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 22043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 22044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 22045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 22046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 22047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 22048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 22049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 22050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 22051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 22052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 22053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 22054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 22055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 22056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 22057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 22058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 22059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 22060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 22061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 22062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 22063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 22064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 22065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 22066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 22067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 22068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 22069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 22070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 22071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 22072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 22073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 22074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 22075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 22076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 22077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 22078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 22079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 22080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 22081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 22082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 22083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 22084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 22085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 22086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 22087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 22088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 22089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 22090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 22091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 22092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 22093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 22094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 22095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 22096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 22097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 22098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 22099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 22100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 22101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 22102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 22103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 22104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 22105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 22106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 22107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 22108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 22109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 22110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 22111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 22112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 22113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 22114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 22115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 22116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 22117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 22118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 22119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 22120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 22121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 22122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 22123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 22124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 22125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 22126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 22127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 22128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 22129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 22130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 22131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 22132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 22133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 22134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 22135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 22136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 22137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 22138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 22139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 22140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 22141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 22142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 22143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 22144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 22145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 22146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 22147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 22148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 22149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 22150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 22151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 22152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 22153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 22154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 22155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 22156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 22157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 22158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 22159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 22160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 22161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 22162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 22163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 22164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 22165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 22166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 22167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 22168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 22169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 22170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 22171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 22172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 22173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 22174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 22175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 22176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 22177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 22178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 22179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 22180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 22181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 22182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 22183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 22184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 22185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 22186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 22187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 22188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 22189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 22190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 22191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 22192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 22193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 22194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 22195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 22196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 22197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 22198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 22199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 22200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 22201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 22202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 22203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 22204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 22205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 22206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 22207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 22208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 22209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 22210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 22211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 22212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 22213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 22214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 22215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 22216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 22217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 22218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 22219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 22220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 22221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 22222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 22223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 22224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 22225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 22226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 22227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 22228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 22229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 22230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 22231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 22232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 22233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 22234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 22235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 22236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 22237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 22238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 22239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 22240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 22241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 22242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 22243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 22244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 22245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 22246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 22247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 22248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 22249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 22250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 22251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 22252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 22253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 22254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 22255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 22256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 22257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 22258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 22259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 22260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 22261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 22262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 22263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 22264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 22265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 22266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 22267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 22268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 22269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 22270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 22271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 22272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 22273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 22274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 22275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 22276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 22277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 22278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 22279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 22280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 22281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 22282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 22283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 22284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 22285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 22286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 22287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 22288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 22289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 22290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 22291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 22292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 22293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 22294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 22295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 22296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 22297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 22298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 22299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 22300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 22301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 22302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 22303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 22304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 22305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 22306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 22307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 22308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 22309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 22310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 22311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 22312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 22313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 22314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 22315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 22316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 22317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 22318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 22319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 22320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 22321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 22322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 22323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 22324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 22325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 22326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 22327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 22328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 22329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 22330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 22331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 22332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 22333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 22334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 22335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 22336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 22337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 22338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 22339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 22340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 22341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 22342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 22343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 22344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 22345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 22346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 22347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 22348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 22349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 22350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 22351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 22352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 22353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 22354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 22355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 22356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 22357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 22358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 22359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 22360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 22361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 22362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 22363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 22364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 22365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 22366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 22367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 22368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 22369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 22370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 22371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 22372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 22373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 22374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 22375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 22376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 22377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 22378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 22379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 22380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 22381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 22382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 22383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 22384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 22385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 22386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 22387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 22388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 22389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 22390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 22391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 22392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 22393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 22394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 22395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 22396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 22397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 22398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 22399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 22400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 22401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 22402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 22403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 22404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 22405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 22406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 22407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 22408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 22409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 22410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 22411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 22412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 22413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 22414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 22415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 22416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 22417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 22418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 22419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 22420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 22421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 22422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 22423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 22424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 22425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 22426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 22427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 22428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 22429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 22430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 22431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 22432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 22433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 22434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 22435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 22436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 22437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 22438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 22439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 22440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 22441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 22442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 22443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 22444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 22445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 22446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 22447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 22448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 22449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 22450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 22451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 22452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 22453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 22454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 22455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 22456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 22457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 22458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 22459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 22460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 22461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 22462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 22463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 22464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 22465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 22466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 22467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 22468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 22469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 22470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 22471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 22472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 22473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 22474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 22475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 22476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 22477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 22478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 22479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 22480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 22481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 22482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 22483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 22484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 22485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 22486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 22487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 22488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 22489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 22490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 22491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 22492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 22493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 22494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 22495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 22496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 22497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 22498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 22499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 22500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 22501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 22502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 22503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 22504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 22505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 22506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 22507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 22508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 22509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 22510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 22511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 22512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 22513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 22514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 22515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 22516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 22517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 22518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 22519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 22520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 22521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 22522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 22523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 22524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 22525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 22526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 22527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 22528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 22529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 22530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 22531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 22532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 22533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 22534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 22535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 22536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 22537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 22538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 22539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 22540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 22541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 22542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 22543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 22544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 22545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 22546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 22547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 22548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 22549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 22550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 22551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 22552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 22553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 22554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 22555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 22556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 22557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 22558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 22559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 22560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 22561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 22562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 22563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 22564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 22565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 22566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 22567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 22568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 22569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 22570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 22571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 22572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 22573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 22574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 22575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 22576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 22577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 22578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 22579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 22580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 22581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 22582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 22583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 22584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 22585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 22586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 22587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 22588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 22589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 22590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 22591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 22592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 22593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 22594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 22595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 22596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 22597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 22598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 22599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 22600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 22601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 22602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 22603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 22604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 22605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 22606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 22607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 22608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 22609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 22610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 22611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 22612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 22613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 22614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 22615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 22616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 22617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 22618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 22619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 22620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 22621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 22622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 22623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 22624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 22625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 22626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 22627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 22628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 22629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 22630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 22631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 22632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 22633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 22634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 22635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 22636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 22637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 22638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 22639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 22640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 22641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 22642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 22643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 22644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 22645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 22646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 22647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 22648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 22649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 22650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 22651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 22652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 22653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 22654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 22655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 22656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 22657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 22658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 22659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 22660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 22661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 22662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 22663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 22664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 22665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 22666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 22667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 22668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 22669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 22670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 22671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 22672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 22673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 22674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 22675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 22676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 22677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 22678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 22679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 22680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 22681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 22682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 22683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 22684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 22685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 22686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 22687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 22688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 22689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 22690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 22691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 22692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 22693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 22694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 22695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 22696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 22697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 22698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 22699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 22700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 22701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 22702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 22703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 22704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 22705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 22706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 22707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 22708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 22709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 22710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 22711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 22712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 22713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 22714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 22715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 22716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 22717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 22718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 22719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 22720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 22721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 22722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 22723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 22724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 22725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 22726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 22727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 22728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 22729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 22730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 22731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 22732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 22733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 22734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 22735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 22736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 22737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 22738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 22739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 22740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 22741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 22742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 22743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 22744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 22745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 22746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 22747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 22748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 22749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 22750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 22751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 22752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 22753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 22754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 22755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 22756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 22757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 22758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 22759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 22760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 22761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 22762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 22763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 22764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 22765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 22766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 22767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 22768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 22769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 22770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 22771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 22772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 22773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 22774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 22775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 22776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 22777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 22778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 22779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 22780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 22781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 22782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 22783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 22784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 22785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 22786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 22787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 22788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 22789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 22790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 22791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 22792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 22793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 22794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 22795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 22796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 22797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 22798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 22799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 22800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 22801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 22802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 22803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 22804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 22805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 22806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 22807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 22808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 22809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 22810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 22811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 22812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 22813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 22814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 22815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 22816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 22817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 22818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 22819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 22820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 22821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 22822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 22823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 22824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 22825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 22826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 22827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 22828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 22829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 22830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 22831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 22832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 22833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 22834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 22835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 22836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 22837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 22838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 22839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 22840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 22841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 22842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 22843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 22844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 22845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 22846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 22847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 22848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 22849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 22850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 22851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 22852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 22853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 22854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 22855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 22856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 22857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 22858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 22859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 22860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 22861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 22862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 22863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 22864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 22865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 22866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 22867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 22868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 22869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 22870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 22871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 22872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 22873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 22874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 22875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 22876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 22877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 22878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 22879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 22880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 22881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 22882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 22883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 22884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 22885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 22886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 22887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 22888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 22889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 22890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 22891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 22892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 22893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 22894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 22895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 22896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 22897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 22898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 22899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 22900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 22901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 22902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 22903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 22904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 22905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 22906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 22907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 22908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 22909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 22910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 22911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 22912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 22913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 22914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 22915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 22916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 22917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 22918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 22919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 22920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 22921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 22922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 22923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 22924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 22925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 22926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 22927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 22928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 22929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 22930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 22931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 22932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 22933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 22934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 22935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 22936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 22937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 22938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 22939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 22940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 22941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 22942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 22943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 22944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 22945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 22946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 22947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 22948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 22949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 22950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 22951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 22952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 22953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 22954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 22955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 22956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 22957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 22958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 22959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 22960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 22961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 22962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 22963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 22964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 22965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 22966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 22967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 22968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 22969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 22970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 22971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 22972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 22973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 22974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 22975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 22976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 22977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 22978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 22979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 22980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 22981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 22982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 22983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 22984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 22985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 22986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 22987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 22988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 22989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 22990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 22991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 22992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 22993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 22994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 22995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 22996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 22997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 22998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 22999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 23000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 23001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 23002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 23003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 23004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 23005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 23006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 23007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 23008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 23009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 23010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 23011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 23012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 23013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 23014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 23015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 23016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 23017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 23018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 23019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 23020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 23021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 23022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 23023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 23024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 23025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 23026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 23027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 23028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 23029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 23030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 23031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 23032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 23033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 23034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 23035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 23036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 23037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 23038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 23039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 23040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 23041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 23042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 23043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 23044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 23045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 23046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 23047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 23048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 23049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 23050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 23051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 23052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 23053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 23054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 23055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 23056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 23057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 23058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 23059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 23060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 23061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 23062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 23063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 23064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 23065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 23066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 23067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 23068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 23069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 23070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 23071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 23072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 23073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 23074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 23075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 23076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 23077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 23078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 23079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 23080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 23081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 23082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 23083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 23084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 23085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 23086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 23087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 23088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 23089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 23090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 23091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 23092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 23093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 23094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 23095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 23096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 23097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 23098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 23099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 23100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 23101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 23102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 23103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 23104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 23105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 23106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 23107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 23108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 23109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 23110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 23111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 23112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 23113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 23114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 23115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 23116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 23117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 23118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 23119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 23120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 23121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 23122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 23123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 23124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 23125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 23126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 23127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 23128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 23129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 23130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 23131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 23132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 23133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 23134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 23135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 23136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 23137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 23138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 23139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 23140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 23141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 23142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 23143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 23144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 23145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 23146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 23147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 23148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 23149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 23150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 23151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 23152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 23153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 23154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 23155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 23156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 23157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 23158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 23159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 23160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 23161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 23162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 23163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 23164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 23165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 23166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 23167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 23168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 23169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 23170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 23171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 23172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 23173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 23174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 23175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 23176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 23177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 23178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 23179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 23180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 23181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 23182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 23183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 23184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 23185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 23186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 23187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 23188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 23189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 23190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 23191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 23192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 23193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 23194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 23195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 23196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 23197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 23198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 23199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 23200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 23201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 23202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 23203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 23204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 23205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 23206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 23207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 23208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 23209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 23210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 23211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 23212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 23213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 23214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 23215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 23216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 23217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 23218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 23219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 23220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 23221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 23222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 23223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 23224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 23225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 23226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 23227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 23228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 23229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 23230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 23231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 23232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 23233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 23234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 23235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 23236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 23237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 23238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 23239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 23240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 23241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 23242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 23243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 23244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 23245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 23246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 23247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 23248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 23249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 23250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 23251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 23252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 23253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 23254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 23255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 23256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 23257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 23258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 23259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 23260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 23261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 23262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 23263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 23264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 23265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 23266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 23267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 23268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 23269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 23270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 23271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 23272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 23273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 23274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 23275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 23276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 23277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 23278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 23279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 23280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 23281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 23282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 23283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 23284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 23285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 23286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 23287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 23288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 23289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 23290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 23291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 23292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 23293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 23294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 23295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 23296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 23297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 23298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 23299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 23300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 23301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 23302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 23303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 23304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 23305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 23306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 23307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 23308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 23309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 23310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 23311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 23312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 23313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 23314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 23315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 23316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 23317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 23318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 23319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 23320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 23321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 23322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 23323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 23324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 23325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 23326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 23327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 23328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 23329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 23330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 23331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 23332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 23333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 23334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 23335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 23336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 23337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 23338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 23339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 23340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 23341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 23342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 23343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 23344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 23345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 23346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 23347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 23348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 23349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 23350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 23351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 23352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 23353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 23354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 23355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 23356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 23357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 23358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 23359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 23360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 23361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 23362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 23363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 23364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 23365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 23366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 23367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 23368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 23369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 23370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 23371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 23372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 23373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 23374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 23375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 23376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 23377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 23378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 23379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 23380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 23381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 23382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 23383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 23384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 23385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 23386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 23387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 23388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 23389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 23390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 23391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 23392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 23393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 23394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 23395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 23396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 23397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 23398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 23399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 23400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 23401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 23402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 23403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 23404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 23405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 23406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 23407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 23408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 23409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 23410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 23411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 23412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 23413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 23414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 23415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 23416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 23417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 23418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 23419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 23420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 23421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 23422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 23423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 23424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 23425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 23426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 23427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 23428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 23429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 23430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 23431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 23432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 23433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 23434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 23435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 23436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 23437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 23438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 23439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 23440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 23441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 23442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 23443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 23444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 23445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 23446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 23447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 23448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 23449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 23450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 23451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 23452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 23453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 23454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 23455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 23456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 23457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 23458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 23459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 23460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 23461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 23462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 23463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 23464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 23465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 23466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 23467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 23468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 23469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 23470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 23471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 23472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 23473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 23474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 23475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 23476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 23477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 23478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 23479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 23480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 23481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 23482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 23483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 23484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 23485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 23486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 23487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 23488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 23489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 23490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 23491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 23492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 23493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 23494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 23495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 23496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 23497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 23498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 23499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 23500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 23501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 23502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 23503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 23504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 23505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 23506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 23507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 23508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 23509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 23510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 23511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 23512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 23513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 23514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 23515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 23516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 23517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 23518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 23519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 23520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 23521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 23522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 23523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 23524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 23525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 23526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 23527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 23528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 23529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 23530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 23531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 23532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 23533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 23534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 23535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 23536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 23537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 23538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 23539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 23540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 23541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 23542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 23543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 23544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 23545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 23546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 23547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 23548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 23549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 23550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 23551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 23552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 23553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 23554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 23555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 23556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 23557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 23558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 23559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 23560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 23561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 23562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 23563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 23564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 23565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 23566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 23567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 23568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 23569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 23570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 23571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 23572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 23573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 23574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 23575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 23576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 23577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 23578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 23579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 23580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 23581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 23582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 23583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 23584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 23585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 23586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 23587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 23588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 23589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 23590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 23591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 23592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 23593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 23594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 23595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 23596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 23597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 23598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 23599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 23600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 23601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 23602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 23603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 23604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 23605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 23606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 23607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 23608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 23609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 23610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 23611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 23612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 23613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 23614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 23615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 23616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 23617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 23618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 23619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 23620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 23621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 23622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 23623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 23624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 23625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 23626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 23627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 23628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 23629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 23630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 23631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 23632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 23633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 23634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 23635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 23636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 23637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 23638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 23639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 23640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 23641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 23642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 23643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 23644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 23645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 23646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 23647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 23648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 23649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 23650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 23651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 23652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 23653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 23654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 23655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 23656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 23657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 23658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 23659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 23660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 23661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 23662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 23663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 23664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 23665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 23666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 23667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 23668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 23669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 23670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 23671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 23672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 23673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 23674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 23675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 23676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 23677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 23678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 23679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 23680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 23681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 23682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 23683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 23684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 23685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 23686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 23687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 23688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 23689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 23690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 23691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 23692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 23693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 23694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 23695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 23696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 23697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 23698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 23699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 23700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 23701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 23702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 23703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 23704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 23705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 23706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 23707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 23708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 23709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 23710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 23711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 23712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 23713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 23714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 23715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 23716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 23717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 23718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 23719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 23720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 23721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 23722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 23723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 23724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 23725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 23726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 23727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 23728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 23729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 23730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 23731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 23732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 23733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 23734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 23735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 23736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 23737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 23738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 23739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 23740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 23741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 23742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 23743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 23744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 23745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 23746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 23747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 23748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 23749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 23750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 23751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 23752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 23753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 23754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 23755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 23756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 23757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 23758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 23759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 23760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 23761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 23762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 23763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 23764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 23765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 23766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 23767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 23768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 23769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 23770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 23771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 23772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 23773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 23774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 23775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 23776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 23777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 23778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 23779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 23780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 23781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 23782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 23783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 23784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 23785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 23786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 23787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 23788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 23789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 23790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 23791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 23792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 23793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 23794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 23795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 23796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 23797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 23798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 23799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 23800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 23801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 23802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 23803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 23804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 23805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 23806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 23807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 23808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 23809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 23810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 23811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 23812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 23813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 23814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 23815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 23816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 23817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 23818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 23819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 23820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 23821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 23822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 23823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 23824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 23825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 23826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 23827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 23828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 23829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 23830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 23831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 23832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 23833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 23834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 23835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 23836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 23837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 23838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 23839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 23840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 23841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 23842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 23843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 23844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 23845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 23846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 23847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 23848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 23849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 23850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 23851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 23852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 23853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 23854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 23855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 23856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 23857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 23858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 23859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 23860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 23861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 23862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 23863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 23864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 23865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 23866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 23867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 23868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 23869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 23870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 23871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 23872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 23873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 23874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 23875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 23876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 23877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 23878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 23879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 23880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 23881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 23882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 23883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 23884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 23885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 23886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 23887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 23888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 23889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 23890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 23891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 23892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 23893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 23894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 23895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 23896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 23897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 23898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 23899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 23900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 23901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 23902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 23903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 23904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 23905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 23906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 23907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 23908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 23909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 23910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 23911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 23912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 23913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 23914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 23915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 23916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 23917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 23918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 23919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 23920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 23921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 23922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 23923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 23924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 23925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 23926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 23927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 23928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 23929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 23930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 23931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 23932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 23933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 23934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 23935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 23936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 23937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 23938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 23939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 23940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 23941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 23942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 23943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 23944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 23945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 23946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 23947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 23948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 23949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 23950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 23951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 23952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 23953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 23954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 23955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 23956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 23957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 23958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 23959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 23960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 23961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 23962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 23963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 23964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 23965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 23966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 23967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 23968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 23969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 23970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 23971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 23972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 23973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 23974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 23975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 23976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 23977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 23978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 23979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 23980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 23981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 23982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 23983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 23984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 23985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 23986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 23987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 23988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 23989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 23990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 23991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 23992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 23993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 23994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 23995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 23996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 23997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 23998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 23999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 24000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 24001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 24002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 24003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 24004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 24005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 24006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 24007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 24008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 24009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 24010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 24011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 24012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 24013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 24014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 24015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 24016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 24017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 24018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 24019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 24020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 24021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 24022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 24023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 24024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 24025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 24026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 24027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 24028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 24029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 24030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 24031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 24032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 24033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 24034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 24035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 24036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 24037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 24038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 24039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 24040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 24041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 24042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 24043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 24044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 24045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 24046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 24047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 24048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 24049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 24050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 24051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 24052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 24053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 24054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 24055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 24056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 24057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 24058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 24059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 24060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 24061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 24062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 24063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 24064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 24065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 24066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 24067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 24068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 24069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 24070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 24071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 24072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 24073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 24074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 24075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 24076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 24077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 24078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 24079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 24080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 24081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 24082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 24083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 24084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 24085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 24086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 24087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 24088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 24089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 24090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 24091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 24092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 24093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 24094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 24095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 24096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 24097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 24098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 24099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 24100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 24101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 24102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 24103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 24104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 24105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 24106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 24107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 24108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 24109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 24110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 24111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 24112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 24113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 24114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 24115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 24116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 24117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 24118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 24119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 24120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 24121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 24122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 24123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 24124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 24125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 24126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 24127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 24128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 24129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 24130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 24131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 24132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 24133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 24134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 24135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 24136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 24137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 24138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 24139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 24140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 24141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 24142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 24143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 24144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 24145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 24146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 24147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 24148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 24149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 24150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 24151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 24152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 24153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 24154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 24155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 24156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 24157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 24158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 24159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 24160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 24161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 24162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 24163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 24164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 24165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 24166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 24167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 24168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 24169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 24170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 24171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 24172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 24173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 24174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 24175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 24176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 24177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 24178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 24179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 24180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 24181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 24182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 24183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 24184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 24185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 24186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 24187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 24188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 24189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 24190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 24191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 24192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 24193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 24194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 24195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 24196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 24197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 24198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 24199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 24200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 24201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 24202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 24203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 24204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 24205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 24206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 24207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 24208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 24209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 24210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 24211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 24212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 24213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 24214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 24215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 24216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 24217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 24218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 24219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 24220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 24221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 24222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 24223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 24224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 24225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 24226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 24227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 24228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 24229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 24230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 24231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 24232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 24233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 24234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 24235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 24236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 24237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 24238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 24239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 24240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 24241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 24242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 24243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 24244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 24245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 24246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 24247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 24248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 24249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 24250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 24251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 24252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 24253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 24254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 24255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 24256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 24257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 24258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 24259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 24260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 24261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 24262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 24263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 24264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 24265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 24266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 24267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 24268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 24269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 24270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 24271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 24272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 24273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 24274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 24275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 24276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 24277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 24278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 24279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 24280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 24281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 24282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 24283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 24284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 24285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 24286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 24287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 24288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 24289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 24290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 24291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 24292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 24293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 24294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 24295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 24296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 24297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 24298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 24299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 24300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 24301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 24302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 24303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 24304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 24305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 24306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 24307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 24308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 24309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 24310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 24311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 24312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 24313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 24314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 24315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 24316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 24317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 24318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 24319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 24320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 24321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 24322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 24323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 24324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 24325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 24326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 24327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHNHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 24328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 24329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 24330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 24331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 24332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 24333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 24334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 24335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 24336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 24337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 24338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 24339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 24340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 24341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 24342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 24343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 24344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 24345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 24346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 24347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 24348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 24349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 24350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 24351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 24352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 24353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 24354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 24355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 24356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 24357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 24358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 24359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 24360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 24361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 24362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 24363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 24364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 24365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 24366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 24367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 24368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 24369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 24370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 24371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 24372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 24373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 24374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 24375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 24376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 24377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 24378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 24379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 24380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 24381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 24382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 24383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 24384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 24385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 24386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 24387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 24388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 24389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 24390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 24391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 24392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 24393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 24394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 24395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 24396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 24397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 24398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 24399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 24400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 24401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 24402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 24403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 24404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 24405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 24406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 24407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 24408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 24409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 24410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 24411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 24412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 24413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 24414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 24415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 24416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 24417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 24418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 24419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 24420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 24421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 24422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 24423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 24424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 24425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 24426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 24427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 24428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 24429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 24430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 24431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 24432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 24433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 24434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 24435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 24436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 24437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 24438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 24439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 24440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 24441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 24442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 24443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 24444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 24445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 24446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 24447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 24448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 24449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 24450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 24451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 24452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 24453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 24454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 24455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 24456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 24457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 24458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 24459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 24460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 24461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 24462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 24463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 24464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 24465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 24466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 24467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 24468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 24469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 24470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 24471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 24472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 24473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 24474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 24475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 24476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 24477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 24478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 24479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 24480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 24481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 24482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 24483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 24484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 24485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 24486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 24487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 24488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 24489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 24490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 24491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 24492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 24493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 24494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 24495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 24496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 24497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 24498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 24499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 24500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 24501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 24502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 24503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 24504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 24505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 24506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 24507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 24508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 24509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 24510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 24511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 24512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 24513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 24514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 24515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 24516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 24517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 24518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 24519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 24520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 24521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 24522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 24523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 24524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 24525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 24526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 24527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 24528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 24529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 24530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 24531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 24532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 24533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 24534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 24535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 24536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 24537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 24538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 24539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 24540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 24541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 24542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 24543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 24544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 24545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 24546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 24547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 24548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 24549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 24550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 24551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 24552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 24553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 24554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 24555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 24556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 24557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 24558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 24559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 24560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 24561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 24562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 24563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 24564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 24565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 24566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 24567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 24568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 24569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 24570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 24571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 24572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 24573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 24574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 24575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 24576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 24577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 24578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 24579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 24580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 24581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 24582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 24583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 24584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 24585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 24586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 24587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 24588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 24589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 24590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 24591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 24592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 24593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 24594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 24595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 24596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 24597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 24598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 24599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 24600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 24601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 24602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 24603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 24604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 24605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 24606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 24607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 24608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 24609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 24610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 24611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 24612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 24613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 24614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 24615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 24616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 24617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 24618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 24619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 24620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 24621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 24622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 24623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 24624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 24625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 24626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 24627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 24628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 24629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 24630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 24631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 24632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 24633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 24634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 24635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 24636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 24637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 24638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 24639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 24640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 24641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 24642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 24643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 24644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 24645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 24646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 24647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 24648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 24649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 24650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 24651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 24652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 24653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 24654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 24655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 24656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 24657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 24658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 24659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 24660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 24661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 24662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 24663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 24664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 24665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 24666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 24667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 24668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 24669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 24670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 24671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 24672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 24673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 24674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 24675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 24676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 24677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 24678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 24679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 24680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 24681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 24682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 24683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 24684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 24685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 24686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 24687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 24688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 24689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 24690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 24691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 24692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 24693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 24694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 24695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 24696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 24697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 24698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 24699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 24700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 24701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 24702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 24703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 24704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 24705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 24706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 24707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 24708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 24709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 24710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 24711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 24712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 24713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 24714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 24715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 24716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 24717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 24718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 24719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 24720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 24721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 24722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 24723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 24724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 24725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 24726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 24727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 24728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 24729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 24730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 24731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 24732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 24733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 24734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 24735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 24736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 24737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 24738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 24739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 24740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 24741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 24742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 24743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 24744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 24745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 24746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 24747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 24748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 24749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 24750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 24751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 24752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 24753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 24754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 24755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 24756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 24757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 24758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 24759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 24760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 24761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 24762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 24763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 24764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 24765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 24766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 24767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 24768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 24769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 24770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 24771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 24772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 24773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 24774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 24775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 24776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 24777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 24778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 24779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 24780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 24781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 24782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 24783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 24784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 24785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 24786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 24787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 24788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 24789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 24790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 24791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 24792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 24793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 24794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 24795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 24796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 24797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 24798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 24799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 24800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 24801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 24802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 24803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 24804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 24805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 24806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 24807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 24808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 24809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 24810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 24811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 24812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 24813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 24814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 24815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 24816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 24817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 24818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 24819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 24820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 24821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 24822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 24823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 24824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 24825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 24826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 24827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 24828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 24829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 24830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 24831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 24832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 24833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 24834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 24835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 24836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 24837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 24838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 24839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 24840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 24841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 24842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 24843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 24844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 24845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 24846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 24847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 24848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 24849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 24850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 24851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 24852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 24853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 24854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 24855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 24856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 24857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 24858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 24859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 24860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 24861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 24862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 24863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 24864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 24865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 24866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 24867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 24868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 24869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 24870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 24871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 24872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 24873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 24874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 24875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 24876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 24877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 24878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 24879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 24880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 24881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 24882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 24883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 24884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 24885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 24886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 24887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 24888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 24889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 24890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 24891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 24892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 24893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 24894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 24895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 24896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 24897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 24898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 24899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 24900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 24901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 24902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 24903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 24904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 24905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 24906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 24907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 24908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 24909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 24910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 24911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 24912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 24913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 24914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 24915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 24916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 24917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 24918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 24919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 24920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 24921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 24922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 24923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 24924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 24925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 24926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 24927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 24928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 24929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 24930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 24931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 24932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 24933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 24934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 24935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 24936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 24937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 24938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 24939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 24940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 24941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 24942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 24943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 24944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 24945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 24946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 24947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 24948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 24949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 24950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 24951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 24952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 24953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 24954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 24955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 24956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 24957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 24958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 24959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 24960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 24961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 24962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 24963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 24964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 24965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 24966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 24967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 24968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 24969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 24970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 24971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 24972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 24973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 24974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 24975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 24976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 24977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 24978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 24979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 24980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 24981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 24982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 24983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 24984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 24985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 24986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 24987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 24988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 24989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 24990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 24991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 24992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 24993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 24994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 24995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 24996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 24997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 24998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 24999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 25000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 25001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 25002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 25003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 25004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 25005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 25006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 25007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 25008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 25009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 25010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 25011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 25012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 25013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 25014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 25015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 25016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 25017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 25018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 25019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 25020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 25021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 25022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 25023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 25024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 25025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 25026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 25027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 25028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 25029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 25030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 25031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 25032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 25033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 25034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 25035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 25036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 25037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 25038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 25039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 25040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 25041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 25042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 25043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 25044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 25045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 25046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 25047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 25048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 25049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 25050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 25051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 25052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 25053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 25054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 25055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 25056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 25057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 25058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 25059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 25060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 25061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 25062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 25063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 25064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 25065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 25066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 25067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 25068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 25069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 25070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 25071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 25072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 25073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 25074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 25075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 25076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 25077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 25078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 25079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 25080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 25081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 25082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 25083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 25084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 25085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 25086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 25087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 25088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 25089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 25090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 25091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 25092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 25093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 25094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 25095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 25096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 25097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 25098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 25099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 25100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 25101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 25102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 25103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 25104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 25105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 25106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 25107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 25108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 25109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 25110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 25111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 25112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 25113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 25114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 25115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 25116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 25117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 25118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 25119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 25120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 25121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 25122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 25123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 25124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 25125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 25126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 25127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 25128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 25129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 25130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 25131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 25132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 25133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 25134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 25135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 25136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 25137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 25138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 25139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 25140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 25141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 25142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 25143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 25144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 25145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 25146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 25147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 25148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 25149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 25150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 25151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 25152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 25153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 25154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 25155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 25156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 25157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 25158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 25159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 25160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 25161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 25162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 25163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 25164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 25165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 25166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 25167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 25168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 25169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 25170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 25171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 25172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 25173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 25174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 25175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 25176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 25177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 25178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 25179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 25180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 25181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 25182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 25183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 25184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 25185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 25186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 25187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 25188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 25189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 25190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 25191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 25192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 25193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 25194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 25195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 25196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 25197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 25198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 25199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 25200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 25201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 25202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 25203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 25204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 25205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 25206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 25207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 25208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 25209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 25210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 25211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 25212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 25213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 25214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 25215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 25216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 25217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 25218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 25219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 25220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 25221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 25222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 25223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 25224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 25225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 25226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 25227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 25228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 25229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 25230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 25231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 25232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 25233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 25234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 25235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 25236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 25237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 25238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 25239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 25240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 25241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 25242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 25243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 25244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 25245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 25246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 25247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 25248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 25249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 25250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 25251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 25252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 25253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 25254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 25255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 25256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 25257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 25258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 25259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 25260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 25261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 25262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 25263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 25264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 25265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 25266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 25267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 25268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 25269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 25270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 25271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 25272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 25273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 25274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 25275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 25276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 25277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 25278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 25279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 25280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 25281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 25282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 25283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 25284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 25285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 25286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 25287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 25288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 25289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 25290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 25291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 25292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 25293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 25294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 25295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 25296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 25297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 25298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 25299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 25300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 25301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 25302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 25303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 25304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 25305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 25306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 25307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 25308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 25309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 25310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 25311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 25312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 25313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 25314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 25315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 25316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 25317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 25318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 25319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 25320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 25321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 25322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 25323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 25324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 25325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 25326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 25327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 25328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 25329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 25330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 25331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 25332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 25333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 25334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 25335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 25336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 25337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 25338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 25339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 25340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 25341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 25342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 25343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 25344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 25345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 25346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 25347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 25348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 25349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 25350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 25351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 25352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 25353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 25354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 25355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 25356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 25357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 25358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 25359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 25360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 25361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 25362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 25363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 25364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 25365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 25366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 25367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 25368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 25369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 25370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 25371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 25372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 25373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 25374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 25375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 25376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 25377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 25378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 25379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 25380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 25381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 25382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 25383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 25384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 25385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 25386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 25387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 25388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 25389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 25390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 25391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 25392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 25393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 25394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 25395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 25396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 25397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 25398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 25399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 25400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 25401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 25402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 25403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 25404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 25405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 25406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 25407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 25408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 25409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 25410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 25411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 25412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 25413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 25414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 25415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 25416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 25417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 25418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 25419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 25420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 25421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 25422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 25423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 25424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 25425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 25426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 25427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 25428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 25429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 25430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 25431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 25432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 25433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 25434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 25435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 25436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 25437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 25438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 25439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 25440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 25441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 25442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 25443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 25444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 25445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 25446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 25447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 25448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 25449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 25450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 25451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 25452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 25453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 25454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 25455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 25456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 25457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 25458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 25459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 25460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 25461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 25462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 25463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 25464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 25465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 25466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 25467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 25468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 25469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 25470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 25471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 25472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 25473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 25474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 25475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 25476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 25477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 25478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 25479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 25480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 25481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 25482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 25483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 25484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 25485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 25486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 25487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 25488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 25489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 25490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 25491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 25492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 25493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 25494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 25495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 25496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 25497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 25498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 25499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 25500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 25501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 25502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 25503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 25504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 25505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 25506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 25507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 25508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 25509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 25510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 25511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 25512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 25513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 25514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 25515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 25516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 25517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 25518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 25519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 25520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 25521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 25522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 25523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 25524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 25525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 25526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 25527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 25528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 25529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 25530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 25531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 25532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 25533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 25534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 25535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 25536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 25537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 25538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 25539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 25540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 25541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 25542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 25543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 25544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 25545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 25546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 25547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 25548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 25549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 25550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 25551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 25552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 25553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 25554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 25555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 25556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 25557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 25558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 25559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 25560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 25561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 25562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 25563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 25564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 25565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 25566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 25567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 25568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 25569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 25570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 25571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 25572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 25573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 25574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 25575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 25576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 25577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 25578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 25579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 25580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 25581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 25582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 25583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 25584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 25585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 25586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 25587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 25588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 25589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 25590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 25591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 25592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 25593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 25594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 25595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 25596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 25597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 25598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 25599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 25600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 25601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 25602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 25603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 25604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 25605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 25606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 25607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 25608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 25609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 25610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 25611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 25612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 25613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 25614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 25615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 25616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 25617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 25618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 25619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 25620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 25621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 25622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 25623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 25624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 25625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 25626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 25627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 25628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 25629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 25630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 25631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 25632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 25633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 25634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 25635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 25636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 25637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 25638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 25639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 25640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 25641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 25642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 25643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 25644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 25645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 25646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 25647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 25648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 25649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 25650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 25651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 25652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 25653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 25654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 25655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 25656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 25657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 25658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 25659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 25660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 25661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 25662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 25663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 25664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 25665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 25666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 25667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 25668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 25669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 25670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 25671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 25672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 25673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 25674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 25675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 25676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 25677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 25678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 25679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 25680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 25681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 25682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 25683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 25684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 25685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 25686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 25687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 25688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 25689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 25690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 25691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 25692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 25693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 25694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 25695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 25696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 25697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 25698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 25699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 25700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 25701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 25702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 25703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 25704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 25705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 25706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 25707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 25708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 25709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 25710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 25711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 25712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 25713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 25714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 25715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 25716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 25717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 25718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 25719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 25720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 25721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 25722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 25723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 25724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 25725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 25726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 25727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 25728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 25729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 25730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 25731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 25732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 25733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 25734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 25735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 25736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 25737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 25738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 25739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 25740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 25741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 25742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 25743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 25744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 25745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 25746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 25747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 25748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 25749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 25750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 25751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 25752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 25753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 25754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 25755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 25756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 25757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 25758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 25759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 25760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 25761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 25762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 25763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 25764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 25765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 25766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 25767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 25768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 25769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 25770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 25771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 25772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 25773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 25774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 25775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 25776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 25777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 25778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 25779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 25780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 25781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 25782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 25783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 25784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 25785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 25786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 25787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 25788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 25789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 25790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 25791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 25792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 25793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 25794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 25795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 25796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 25797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 25798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 25799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 25800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 25801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 25802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 25803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 25804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 25805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 25806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 25807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 25808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 25809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 25810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 25811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 25812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 25813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 25814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 25815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 25816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 25817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 25818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 25819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 25820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 25821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 25822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 25823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 25824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 25825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 25826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 25827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 25828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 25829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 25830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 25831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 25832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 25833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 25834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 25835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 25836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 25837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 25838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 25839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 25840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 25841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 25842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 25843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 25844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 25845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 25846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 25847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 25848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 25849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 25850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 25851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 25852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 25853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 25854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 25855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 25856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 25857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 25858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 25859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 25860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 25861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 25862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 25863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 25864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 25865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 25866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 25867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 25868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 25869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 25870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 25871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 25872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 25873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 25874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 25875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 25876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 25877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 25878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 25879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 25880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 25881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 25882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 25883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 25884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 25885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 25886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 25887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 25888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 25889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 25890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 25891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 25892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 25893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 25894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 25895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 25896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 25897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 25898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 25899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 25900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 25901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 25902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 25903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 25904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 25905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 25906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 25907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 25908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 25909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 25910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 25911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 25912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 25913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 25914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 25915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 25916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 25917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 25918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 25919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 25920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 25921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 25922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 25923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 25924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 25925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 25926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 25927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 25928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 25929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 25930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 25931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 25932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 25933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 25934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 25935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 25936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 25937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 25938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 25939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 25940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 25941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 25942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 25943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 25944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 25945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 25946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 25947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 25948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 25949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 25950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 25951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 25952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 25953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 25954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 25955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 25956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 25957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 25958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 25959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 25960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 25961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 25962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 25963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 25964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 25965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 25966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 25967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 25968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 25969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 25970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 25971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 25972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 25973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 25974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 25975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 25976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 25977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 25978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 25979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 25980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 25981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 25982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 25983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 25984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 25985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 25986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 25987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 25988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 25989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 25990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 25991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 25992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 25993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 25994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 25995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 25996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 25997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 25998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 25999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 26000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 26001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 26002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 26003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 26004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 26005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 26006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 26007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 26008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 26009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 26010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 26011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 26012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 26013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 26014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 26015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 26016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 26017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 26018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 26019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 26020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 26021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 26022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 26023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 26024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 26025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 26026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 26027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 26028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 26029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 26030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 26031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 26032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 26033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 26034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 26035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 26036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 26037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 26038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 26039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 26040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 26041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 26042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 26043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 26044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 26045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 26046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 26047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 26048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 26049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 26050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 26051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 26052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 26053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 26054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 26055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 26056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 26057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 26058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 26059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 26060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 26061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 26062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 26063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 26064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 26065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 26066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 26067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 26068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 26069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 26070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 26071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 26072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 26073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 26074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 26075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 26076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 26077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 26078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 26079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 26080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 26081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 26082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 26083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 26084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 26085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 26086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 26087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 26088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 26089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 26090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 26091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 26092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 26093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 26094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 26095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 26096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 26097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 26098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 26099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 26100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 26101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 26102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 26103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 26104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 26105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 26106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 26107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 26108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 26109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 26110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 26111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 26112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 26113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 26114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 26115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 26116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 26117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 26118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 26119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 26120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 26121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 26122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 26123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 26124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 26125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 26126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 26127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 26128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 26129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 26130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 26131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 26132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 26133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 26134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 26135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 26136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 26137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 26138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 26139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 26140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 26141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 26142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 26143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 26144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 26145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 26146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 26147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 26148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 26149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 26150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 26151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 26152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 26153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 26154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 26155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 26156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 26157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 26158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 26159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 26160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 26161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 26162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 26163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 26164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 26165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 26166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 26167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 26168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 26169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 26170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 26171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 26172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 26173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 26174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 26175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 26176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 26177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 26178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 26179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 26180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 26181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 26182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 26183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 26184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 26185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 26186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 26187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 26188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 26189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 26190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 26191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 26192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 26193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 26194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 26195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 26196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 26197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 26198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 26199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 26200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 26201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 26202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 26203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 26204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 26205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 26206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 26207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 26208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 26209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 26210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 26211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 26212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 26213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 26214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 26215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 26216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 26217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 26218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 26219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 26220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 26221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 26222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 26223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 26224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 26225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 26226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 26227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 26228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 26229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 26230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 26231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 26232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 26233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 26234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 26235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 26236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 26237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 26238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 26239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 26240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 26241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 26242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 26243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 26244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 26245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 26246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 26247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 26248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 26249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 26250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 26251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 26252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 26253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 26254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 26255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 26256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 26257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 26258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 26259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 26260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 26261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 26262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 26263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 26264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 26265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 26266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 26267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 26268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 26269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 26270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 26271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 26272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 26273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 26274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 26275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 26276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 26277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 26278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 26279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 26280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 26281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 26282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 26283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 26284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 26285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 26286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 26287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 26288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 26289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 26290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 26291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 26292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 26293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 26294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 26295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 26296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 26297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 26298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 26299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 26300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 26301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 26302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 26303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 26304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 26305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 26306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 26307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 26308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 26309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 26310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 26311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 26312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 26313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 26314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 26315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 26316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 26317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 26318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 26319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 26320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 26321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 26322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 26323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 26324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 26325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 26326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 26327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 26328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 26329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 26330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 26331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 26332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 26333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 26334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 26335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 26336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 26337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 26338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 26339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 26340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 26341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDSAGEPPSMTQLLRR
